United States Patent 12,416,006 (CELL DEATH-INDUCING DFFA-LIKE EFFECTOR B (CIDEB) IRNA COMPOSITIONS AND METHODS OF USE THEREOF) - sequence listing, part 2

SEQ ID NO: 2664 - RNA, 23 nt, synthetic construct
  source 1..23: mol_type = other RNA
cacctttctggcctcccacttgc

SEQ ID NO: 2665 - RNA, 23 nt, synthetic construct
  source 1..23: mol_type = other RNA
acctttctggcctcccacttgcc

SEQ ID NO: 2666 - RNA, 23 nt, synthetic construct
  source 1..23: mol_type = other RNA
tttctggcctcccacttgccctg

SEQ ID NO: 2667 - RNA, 23 nt, synthetic construct
  source 1..23: mol_type = other RNA
caggcatcttgatcccagcctga

SEQ ID NO: 2668 - RNA, 23 nt, synthetic construct
  source 1..23: mol_type = other RNA
ccaatgcctcctgtccctaaact

SEQ ID NO: 2669 - RNA, 23 nt, synthetic construct
  source 1..23: mol_type = other RNA
caatgcctcctgtccctaaactc

SEQ ID NO: 2670 - RNA, 23 nt, synthetic construct
  source 1..23: mol_type = other RNA
aatgcctcctgtccctaaactcc

SEQ ID NO: 2671 - RNA, 23 nt, synthetic construct
  source 1..23: mol_type = other RNA
ctcaaactaacaaaaacatttcc

SEQ ID NO: 2672 - RNA, 23 nt, synthetic construct
  source 1..23: mol_type = other RNA
tcaaactaacaaaaacatttcca

SEQ ID NO: 2673 - RNA, 23 nt, synthetic construct
  source 1..23: mol_type = other RNA
caaactaacaaaaacatttccaa

SEQ ID NO: 2674 - RNA, 23 nt, synthetic construct
  source 1..23: mol_type = other RNA
ggaaggaaagagcagatcccagg

SEQ ID NO: 2675 - RNA, 23 nt, synthetic construct
  source 1..23: mol_type = other RNA
gagcagatcccaggtttgtaaca

SEQ ID NO: 2676 - RNA, 23 nt, synthetic construct
  source 1..23: mol_type = other RNA
agcagatcccaggtttgtaacag

SEQ ID NO: 2677 - RNA, 23 nt, synthetic construct
  source 1..23: mol_type = other RNA
cagatcccaggtttgtaacagaa

SEQ ID NO: 2678 - RNA, 23 nt, synthetic construct
  source 1..23: mol_type = other RNA
tcccaggtttgtaacagaaaaca

SEQ ID NO: 2679 - RNA, 23 nt, synthetic construct
  source 1..23: mol_type = other RNA
cccaggtttgtaacagaaaacac

SEQ ID NO: 2680 - RNA, 23 nt, synthetic construct
  source 1..23: mol_type = other RNA
ccaggtttgtaacagaaaacacc

SEQ ID NO: 2681 - RNA, 23 nt, synthetic construct
  source 1..23: mol_type = other RNA
caggtttgtaacagaaaacacca

SEQ ID NO: 2682 - RNA, 23 nt, synthetic construct
  source 1..23: mol_type = other RNA
tgtaacagaaaacaccactaaag

SEQ ID NO: 2683 - RNA, 23 nt, synthetic construct
  source 1..23: mol_type = other RNA
aacagaaaacaccactaaagccc

SEQ ID NO: 2684 - RNA, 23 nt, synthetic construct
  source 1..23: mol_type = other RNA
agcacaggagagaaccacccagc

SEQ ID NO: 2685 - RNA, 23 nt, synthetic construct
  source 1..23: mol_type = other RNA
gagaaccacccagcccagaagtt

SEQ ID NO: 2686 - RNA, 23 nt, synthetic construct
  source 1..23: mol_type = other RNA
agaaccacccagcccagaagttc

SEQ ID NO: 2687 - RNA, 23 nt, synthetic construct
  source 1..23: mol_type = other RNA
gaaccacccagcccagaagttcc

SEQ ID NO: 2688 - RNA, 23 nt, synthetic construct
  source 1..23: mol_type = other RNA
aaccacccagcccagaagttcca

SEQ ID NO: 2689 - RNA, 23 nt, synthetic construct
  source 1..23: mol_type = other RNA
accacccagcccagaagttccag

SEQ ID NO: 2690 - RNA, 23 nt, synthetic construct
  source 1..23: mol_type = other RNA
gcccagaagttccagggaaggaa

SEQ ID NO: 2691 - RNA, 23 nt, synthetic construct
  source 1..23: mol_type = other RNA
cccagaagttccagggaaggaac

SEQ ID NO: 2692 - RNA, 23 nt, synthetic construct
  source 1..23: mol_type = other RNA
ccagaagttccagggaaggaact

SEQ ID NO: 2693 - RNA, 23 nt, synthetic construct
  source 1..23: mol_type = other RNA
cagaagttccagggaaggaactc

SEQ ID NO: 2694 - RNA, 23 nt, synthetic construct
  source 1..23: mol_type = other RNA
agaagttccagggaaggaactct

SEQ ID NO: 2695 - RNA, 23 nt, synthetic construct
  source 1..23: mol_type = other RNA
gaagttccagggaaggaactctc

SEQ ID NO: 2696 - RNA, 23 nt, synthetic construct
  source 1..23: mol_type = other RNA
aagttccagggaaggaactctcc

SEQ ID NO: 2697 - RNA, 23 nt, synthetic construct
  source 1..23: mol_type = other RNA
cggtccaccatggagtacctctc

SEQ ID NO: 2698 - RNA, 23 nt, synthetic construct
  source 1..23: mol_type = other RNA
tccaccatggagtacctctcagc

SEQ ID NO: 2699 - RNA, 23 nt, synthetic construct
  source 1..23: mol_type = other RNA
caccatggagtacctctcagctc

SEQ ID NO: 2700 - RNA, 23 nt, synthetic construct
  source 1..23: mol_type = other RNA
ccatggagtacctctcagctctg

SEQ ID NO: 2701 - RNA, 23 nt, synthetic construct
  source 1..23: mol_type = other RNA
acttactcaggtcagtatctaat

SEQ ID NO: 2702 - RNA, 23 nt, synthetic construct
  source 1..23: mol_type = other RNA
ggtcagtatctaatataagctcg

SEQ ID NO: 2703 - RNA, 23 nt, synthetic construct
  source 1..23: mol_type = other RNA
gtcagtatctaatataagctcgg

SEQ ID NO: 2704 - RNA, 23 nt, synthetic construct
  source 1..23: mol_type = other RNA
tcagtatctaatataagctcgga

SEQ ID NO: 2705 - RNA, 23 nt, synthetic construct
  source 1..23: mol_type = other RNA
tatctaatataagctcggagttt

SEQ ID NO: 2706 - RNA, 23 nt, synthetic construct
  source 1..23: mol_type = other RNA
atctaatataagctcggagtttg

SEQ ID NO: 2707 - RNA, 23 nt, synthetic construct
  source 1..23: mol_type = other RNA
tataagctcggagtttggacgga

SEQ ID NO: 2708 - RNA, 23 nt, synthetic construct
  source 1..23: mol_type = other RNA
ataagctcggagtttggacggag

SEQ ID NO: 2709 - RNA, 23 nt, synthetic construct
  source 1..23: mol_type = other RNA
tcggagtttggacggagggtctg

SEQ ID NO: 2710 - RNA, 23 nt, synthetic construct
  source 1..23: mol_type = other RNA
tttggacggagggtctggacctc

SEQ ID NO: 2711 - RNA, 23 nt, synthetic construct
  source 1..23: mol_type = other RNA
ccagcgacctttccgtgtctgtg

SEQ ID NO: 2712 - RNA, 23 nt, synthetic construct
  source 1..23: mol_type = other RNA
cacaagcggaccatccggaaagg

SEQ ID NO: 2713 - RNA, 23 nt, synthetic construct
  source 1..23: mol_type = other RNA
accatccggaaaggcctgacagc

SEQ ID NO: 2714 - RNA, 23 nt, synthetic construct
  source 1..23: mol_type = other RNA
ccaggagctgctagccaaagcat

SEQ ID NO: 2715 - RNA, 23 nt, synthetic construct
  source 1..23: mol_type = other RNA
caggagctgctagccaaagcatt

SEQ ID NO: 2716 - RNA, 23 nt, synthetic construct
  source 1..23: mol_type = other RNA
aggagctgctagccaaagcattg

SEQ ID NO: 2717 - RNA, 23 nt, synthetic construct
  source 1..23: mol_type = other RNA
ggagctgctagccaaagcattgg

SEQ ID NO: 2718 - RNA, 23 nt, synthetic construct
  source 1..23: mol_type = other RNA
tgctagccaaagcattggagacc

SEQ ID NO: 2719 - RNA, 23 nt, synthetic construct
  source 1..23: mol_type = other RNA
gctagccaaagcattggagaccc

SEQ ID NO: 2720 - RNA, 23 nt, synthetic construct
  source 1..23: mol_type = other RNA
aaagcattggagaccctactgct

SEQ ID NO: 2721 - RNA, 23 nt, synthetic construct
  source 1..23: mol_type = other RNA
aagcattggagaccctactgctg

SEQ ID NO: 2722 - RNA, 23 nt, synthetic construct
  source 1..23: mol_type = other RNA
gcattggagaccctactgctgaa

SEQ ID NO: 2723 - RNA, 23 nt, synthetic construct
  source 1..23: mol_type = other RNA
ttggagaccctactgctgaatgg

SEQ ID NO: 2724 - RNA, 23 nt, synthetic construct
  source 1..23: mol_type = other RNA
tggagaccctactgctgaatgga

SEQ ID NO: 2725 - RNA, 23 nt, synthetic construct
  source 1..23: mol_type = other RNA
agaccctactgctgaatggagtg

SEQ ID NO: 2726 - RNA, 23 nt, synthetic construct
  source 1..23: mol_type = other RNA
gaccctactgctgaatggagtgc

SEQ ID NO: 2727 - RNA, 23 nt, synthetic construct
  source 1..23: mol_type = other RNA
accctactgctgaatggagtgct

SEQ ID NO: 2728 - RNA, 23 nt, synthetic construct
  source 1..23: mol_type = other RNA
ccctactgctgaatggagtgcta

SEQ ID NO: 2729 - RNA, 23 nt, synthetic construct
  source 1..23: mol_type = other RNA
cctactgctgaatggagtgctaa

SEQ ID NO: 2730 - RNA, 23 nt, synthetic construct
  source 1..23: mol_type = other RNA
ctgctgaatggagtgctaaccct

SEQ ID NO: 2731 - RNA, 23 nt, synthetic construct
  source 1..23: mol_type = other RNA
tgctgaatggagtgctaaccctg

SEQ ID NO: 2732 - RNA, 23 nt, synthetic construct
  source 1..23: mol_type = other RNA
gctgaatggagtgctaaccctgg

SEQ ID NO: 2733 - RNA, 23 nt, synthetic construct
  source 1..23: mol_type = other RNA
aatggagtgctaaccctggtgct

SEQ ID NO: 2734 - RNA, 23 nt, synthetic construct
  source 1..23: mol_type = other RNA
atggagtgctaaccctggtgcta

SEQ ID NO: 2735 - RNA, 23 nt, synthetic construct
  source 1..23: mol_type = other RNA
tggagtgctaaccctggtgctag

SEQ ID NO: 2736 - RNA, 23 nt, synthetic construct
  source 1..23: mol_type = other RNA
ctaaccctggtgctagaggagga

SEQ ID NO: 2737 - RNA, 23 nt, synthetic construct
  source 1..23: mol_type = other RNA
aaccctggtgctagaggaggatg

SEQ ID NO: 2738 - RNA, 23 nt, synthetic construct
  source 1..23: mol_type = other RNA
ctggtgctagaggaggatggaac

SEQ ID NO: 2739 - RNA, 23 nt, synthetic construct
  source 1..23: mol_type = other RNA
tggtgctagaggaggatggaact

SEQ ID NO: 2740 - RNA, 23 nt, synthetic construct
  source 1..23: mol_type = other RNA
tgctagaggaggatggaactgca

SEQ ID NO: 2741 - RNA, 23 nt, synthetic construct
  source 1..23: mol_type = other RNA
aggaggatggaactgcagtggac

SEQ ID NO: 2742 - RNA, 23 nt, synthetic construct
  source 1..23: mol_type = other RNA
gaggatggaactgcagtggacag

SEQ ID NO: 2743 - RNA, 23 nt, synthetic construct
  source 1..23: mol_type = other RNA
aggatggaactgcagtggacagt

SEQ ID NO: 2744 - RNA, 23 nt, synthetic construct
  source 1..23: mol_type = other RNA
ggatggaactgcagtggacagtg

SEQ ID NO: 2745 - RNA, 23 nt, synthetic construct
  source 1..23: mol_type = other RNA
gatggaactgcagtggacagtga

SEQ ID NO: 2746 - RNA, 23 nt, synthetic construct
  source 1..23: mol_type = other RNA
tggaactgcagtggacagtgagg

SEQ ID NO: 2747 - RNA, 23 nt, synthetic construct
  source 1..23: mol_type = other RNA
gaactgcagtggacagtgaggac

SEQ ID NO: 2748 - RNA, 23 nt, synthetic construct
  source 1..23: mol_type = other RNA
aactgcagtggacagtgaggact

SEQ ID NO: 2749 - RNA, 23 nt, synthetic construct
  source 1..23: mol_type = other RNA
actgcagtggacagtgaggactt

SEQ ID NO: 2750 - RNA, 23 nt, synthetic construct
  source 1..23: mol_type = other RNA
ctgcagtggacagtgaggacttc

SEQ ID NO: 2751 - RNA, 23 nt, synthetic construct
  source 1..23: mol_type = other RNA
tgcagtggacagtgaggacttct

SEQ ID NO: 2752 - RNA, 23 nt, synthetic construct
  source 1..23: mol_type = other RNA
gcagtggacagtgaggacttctt

SEQ ID NO: 2753 - RNA, 23 nt, synthetic construct
  source 1..23: mol_type = other RNA
agtggacagtgaggacttcttcc

SEQ ID NO: 2754 - RNA, 23 nt, synthetic construct
  source 1..23: mol_type = other RNA
gacagtgaggacttcttccagct

SEQ ID NO: 2755 - RNA, 23 nt, synthetic construct
  source 1..23: mol_type = other RNA
agtgaggacttcttccagctgct

SEQ ID NO: 2756 - RNA, 23 nt, synthetic construct
  source 1..23: mol_type = other RNA
gtgaggacttcttccagctgctg

SEQ ID NO: 2757 - RNA, 23 nt, synthetic construct
  source 1..23: mol_type = other RNA
gaggacttcttccagctgctgga

SEQ ID NO: 2758 - RNA, 23 nt, synthetic construct
  source 1..23: mol_type = other RNA
cttcttccagctgctggaggatg

SEQ ID NO: 2759 - RNA, 23 nt, synthetic construct
  source 1..23: mol_type = other RNA
tccagctgctggaggatgacacg

SEQ ID NO: 2760 - RNA, 23 nt, synthetic construct
  source 1..23: mol_type = other RNA
cagctgctggaggatgacacgtg

SEQ ID NO: 2761 - RNA, 23 nt, synthetic construct
  source 1..23: mol_type = other RNA
tgctggaggatgacacgtgcctg

SEQ ID NO: 2762 - RNA, 23 nt, synthetic construct
  source 1..23: mol_type = other RNA
gaggatgacacgtgcctgatggt

SEQ ID NO: 2763 - RNA, 23 nt, synthetic construct
  source 1..23: mol_type = other RNA
aggatgacacgtgcctgatggtg

SEQ ID NO: 2764 - RNA, 23 nt, synthetic construct
  source 1..23: mol_type = other RNA
atgacacgtgcctgatggtgttg

SEQ ID NO: 2765 - RNA, 23 nt, synthetic construct
  source 1..23: mol_type = other RNA
ttgcagtctggtcagagctggag

SEQ ID NO: 2766 - RNA, 23 nt, synthetic construct
  source 1..23: mol_type = other RNA
cctacaaggagtggagtgctgtc

SEQ ID NO: 2767 - RNA, 23 nt, synthetic construct
  source 1..23: mol_type = other RNA
ctacaaggagtggagtgctgtca

SEQ ID NO: 2768 - RNA, 23 nt, synthetic construct
  source 1..23: mol_type = other RNA
acaaggagtggagtgctgtcata

SEQ ID NO: 2769 - RNA, 23 nt, synthetic construct
  source 1..23: mol_type = other RNA
aaggagtggagtgctgtcatatg

SEQ ID NO: 2770 - RNA, 23 nt, synthetic construct
  source 1..23: mol_type = other RNA
agtggagtgctgtcatatggcct

SEQ ID NO: 2771 - RNA, 23 nt, synthetic construct
  source 1..23: mol_type = other RNA
gtggagtgctgtcatatggcctg

SEQ ID NO: 2772 - RNA, 23 nt, synthetic construct
  source 1..23: mol_type = other RNA
tggagtgctgtcatatggcctgg

SEQ ID NO: 2773 - RNA, 23 nt, synthetic construct
  source 1..23: mol_type = other RNA
ggagtgctgtcatatggcctggg

SEQ ID NO: 2774 - RNA, 23 nt, synthetic construct
  source 1..23: mol_type = other RNA
gtgctgtcatatggcctgggacg

SEQ ID NO: 2775 - RNA, 23 nt, synthetic construct
  source 1..23: mol_type = other RNA
tgctgtcatatggcctgggacgg

SEQ ID NO: 2776 - RNA, 23 nt, synthetic construct
  source 1..23: mol_type = other RNA
cccaagcacagcaaggacatcgc

SEQ ID NO: 2777 - RNA, 23 nt, synthetic construct
  source 1..23: mol_type = other RNA
cgattcacctttgacgtgtacaa

SEQ ID NO: 2778 - RNA, 23 nt, synthetic construct
  source 1..23: mol_type = other RNA
gattcacctttgacgtgtacaag

SEQ ID NO: 2779 - RNA, 23 nt, synthetic construct
  source 1..23: mol_type = other RNA
attcacctttgacgtgtacaagc

SEQ ID NO: 2780 - RNA, 23 nt, synthetic construct
  source 1..23: mol_type = other RNA
ttcacctttgacgtgtacaagca

SEQ ID NO: 2781 - RNA, 23 nt, synthetic construct
  source 1..23: mol_type = other RNA
cacctttgacgtgtacaagcaaa

SEQ ID NO: 2782 - RNA, 23 nt, synthetic construct
  source 1..23: mol_type = other RNA
tttgacgtgtacaagcaaaaccc

SEQ ID NO: 2783 - RNA, 23 nt, synthetic construct
  source 1..23: mol_type = other RNA
ttgacgtgtacaagcaaaaccct

SEQ ID NO: 2784 - RNA, 23 nt, synthetic construct
  source 1..23: mol_type = other RNA
tgacgtgtacaagcaaaaccctc

SEQ ID NO: 2785 - RNA, 23 nt, synthetic construct
  source 1..23: mol_type = other RNA
gacgtgtacaagcaaaaccctcg

SEQ ID NO: 2786 - RNA, 23 nt, synthetic construct
  source 1..23: mol_type = other RNA
tacaagcaaaaccctcgagacct

SEQ ID NO: 2787 - RNA, 23 nt, synthetic construct
  source 1..23: mol_type = other RNA
acaagcaaaaccctcgagacctc

SEQ ID NO: 2788 - RNA, 23 nt, synthetic construct
  source 1..23: mol_type = other RNA
caagcaaaaccctcgagacctct

SEQ ID NO: 2789 - RNA, 23 nt, synthetic construct
  source 1..23: mol_type = other RNA
tcgagacctctttggcagcctga

SEQ ID NO: 2790 - RNA, 23 nt, synthetic construct
  source 1..23: mol_type = other RNA
gacctctttggcagcctgaatgt

SEQ ID NO: 2791 - RNA, 23 nt, synthetic construct
  source 1..23: mol_type = other RNA
acctctttggcagcctgaatgtc

SEQ ID NO: 2792 - RNA, 23 nt, synthetic construct
  source 1..23: mol_type = other RNA
ctctttggcagcctgaatgtcaa

SEQ ID NO: 2793 - RNA, 23 nt, synthetic construct
  source 1..23: mol_type = other RNA
tctttggcagcctgaatgtcaaa

SEQ ID NO: 2794 - RNA, 23 nt, synthetic construct
  source 1..23: mol_type = other RNA
tttggcagcctgaatgtcaaagc

SEQ ID NO: 2795 - RNA, 23 nt, synthetic construct
  source 1..23: mol_type = other RNA
tggcagcctgaatgtcaaagcca

SEQ ID NO: 2796 - RNA, 23 nt, synthetic construct
  source 1..23: mol_type = other RNA
ggcagcctgaatgtcaaagccac

SEQ ID NO: 2797 - RNA, 23 nt, synthetic construct
  source 1..23: mol_type = other RNA
gcagcctgaatgtcaaagccaca

SEQ ID NO: 2798 - RNA, 23 nt, synthetic construct
  source 1..23: mol_type = other RNA
gaatgtcaaagccacattctacg

SEQ ID NO: 2799 - RNA, 23 nt, synthetic construct
  source 1..23: mol_type = other RNA
aaagccacattctacgggctcta

SEQ ID NO: 2800 - RNA, 23 nt, synthetic construct
  source 1..23: mol_type = other RNA
aagccacattctacgggctctac

SEQ ID NO: 2801 - RNA, 23 nt, synthetic construct
  source 1..23: mol_type = other RNA
gccacattctacgggctctactc

SEQ ID NO: 2802 - RNA, 23 nt, synthetic construct
  source 1..23: mol_type = other RNA
cacattctacgggctctactcta

SEQ ID NO: 2803 - RNA, 23 nt, synthetic construct
  source 1..23: mol_type = other RNA
acattctacgggctctactctat

SEQ ID NO: 2804 - RNA, 23 nt, synthetic construct
  source 1..23: mol_type = other RNA
attctacgggctctactctatga

SEQ ID NO: 2805 - RNA, 23 nt, synthetic construct
  source 1..23: mol_type = other RNA
ctacgggctctactctatgagtt

SEQ ID NO: 2806 - RNA, 23 nt, synthetic construct
  source 1..23: mol_type = other RNA
acgggctctactctatgagttgt

SEQ ID NO: 2807 - RNA, 23 nt, synthetic construct
  source 1..23: mol_type = other RNA
cgggctctactctatgagttgtg

SEQ ID NO: 2808 - RNA, 23 nt, synthetic construct
  source 1..23: mol_type = other RNA
ctctactctatgagttgtgactt

SEQ ID NO: 2809 - RNA, 23 nt, synthetic construct
  source 1..23: mol_type = other RNA
tctactctatgagttgtgacttt

SEQ ID NO: 2810 - RNA, 23 nt, synthetic construct
  source 1..23: mol_type = other RNA
ctactctatgagttgtgactttc

SEQ ID NO: 2811 - RNA, 23 nt, synthetic construct
  source 1..23: mol_type = other RNA
tactctatgagttgtgactttca

SEQ ID NO: 2812 - RNA, 23 nt, synthetic construct
  source 1..23: mol_type = other RNA
ctctatgagttgtgactttcaag

SEQ ID NO: 2813 - RNA, 23 nt, synthetic construct
  source 1..23: mol_type = other RNA
atgagttgtgactttcaaggact

SEQ ID NO: 2814 - RNA, 23 nt, synthetic construct
  source 1..23: mol_type = other RNA
tgagttgtgactttcaaggactt

SEQ ID NO: 2815 - RNA, 23 nt, synthetic construct
  source 1..23: mol_type = other RNA
acttggcccaaagaaagtactca

SEQ ID NO: 2816 - RNA, 23 nt, synthetic construct
  source 1..23: mol_type = other RNA
cttggcccaaagaaagtactcag

SEQ ID NO: 2817 - RNA, 23 nt, synthetic construct
  source 1..23: mol_type = other RNA
ttggcccaaagaaagtactcagg

SEQ ID NO: 2818 - RNA, 23 nt, synthetic construct
  source 1..23: mol_type = other RNA
ggcccaaagaaagtactcaggga

SEQ ID NO: 2819 - RNA, 23 nt, synthetic construct
  source 1..23: mol_type = other RNA
ccaaagaaagtactcagggagct

SEQ ID NO: 2820 - RNA, 23 nt, synthetic construct
  source 1..23: mol_type = other RNA
caaagaaagtactcagggagctc

SEQ ID NO: 2821 - RNA, 23 nt, synthetic construct
  source 1..23: mol_type = other RNA
aaagaaagtactcagggagctcc

SEQ ID NO: 2822 - RNA, 23 nt, synthetic construct
  source 1..23: mol_type = other RNA
aaagtactcagggagctccttcg

SEQ ID NO: 2823 - RNA, 23 nt, synthetic construct
  source 1..23: mol_type = other RNA
tcagggagctccttcgttggacc

SEQ ID NO: 2824 - RNA, 23 nt, synthetic construct
  source 1..23: mol_type = other RNA
agggagctccttcgttggacctc

SEQ ID NO: 2825 - RNA, 23 nt, synthetic construct
  source 1..23: mol_type = other RNA
ccttcgttggacctccacactgc

SEQ ID NO: 2826 - RNA, 23 nt, synthetic construct
  source 1..23: mol_type = other RNA
ttcgttggacctccacactgctg

SEQ ID NO: 2827 - RNA, 23 nt, synthetic construct
  source 1..23: mol_type = other RNA
tggacctccacactgctgcaagg

SEQ ID NO: 2828 - RNA, 23 nt, synthetic construct
  source 1..23: mol_type = other RNA
aaggcctgggccatatgttgctg

SEQ ID NO: 2829 - RNA, 23 nt, synthetic construct
  source 1..23: mol_type = other RNA
ctgggccatatgttgctgggaat

SEQ ID NO: 2830 - RNA, 23 nt, synthetic construct
  source 1..23: mol_type = other RNA
tgggccatatgttgctgggaatt

SEQ ID NO: 2831 - RNA, 23 nt, synthetic construct
  source 1..23: mol_type = other RNA
ggccatatgttgctgggaatttc

SEQ ID NO: 2832 - RNA, 23 nt, synthetic construct
  source 1..23: mol_type = other RNA
gccatatgttgctgggaatttcc

SEQ ID NO: 2833 - RNA, 23 nt, synthetic construct
  source 1..23: mol_type = other RNA
tatgttgctgggaatttcctcca

SEQ ID NO: 2834 - RNA, 23 nt, synthetic construct
  source 1..23: mol_type = other RNA
gctgggaatttcctccacccttc

SEQ ID NO: 2835 - RNA, 23 nt, synthetic construct
  source 1..23: mol_type = other RNA
atttcctccacccttcgtcatgc

SEQ ID NO: 2836 - RNA, 23 nt, synthetic construct
  source 1..23: mol_type = other RNA
agaagggccgcctccattcctac

SEQ ID NO: 2837 - RNA, 23 nt, synthetic construct
  source 1..23: mol_type = other RNA
gggccgcctccattcctactaag

SEQ ID NO: 2838 - RNA, 23 nt, synthetic construct
  source 1..23: mol_type = other RNA
ggccgcctccattcctactaagg

SEQ ID NO: 2839 - RNA, 23 nt, synthetic construct
  source 1..23: mol_type = other RNA
gacccactgcaaagactatgaca

SEQ ID NO: 2840 - RNA, 23 nt, synthetic construct
  source 1..23: mol_type = other RNA
acccactgcaaagactatgacag

SEQ ID NO: 2841 - RNA, 23 nt, synthetic construct
  source 1..23: mol_type = other RNA
cccactgcaaagactatgacagc

SEQ ID NO: 2842 - RNA, 23 nt, synthetic construct
  source 1..23: mol_type = other RNA
caaagactatgacagcatcaaat

SEQ ID NO: 2843 - RNA, 23 nt, synthetic construct
  source 1..23: mol_type = other RNA
atgacagcatcaaatttcaggac

SEQ ID NO: 2844 - RNA, 23 nt, synthetic construct
  source 1..23: mol_type = other RNA
gacagcatcaaatttcaggacct

SEQ ID NO: 2845 - RNA, 23 nt, synthetic construct
  source 1..23: mol_type = other RNA
acagcatcaaatttcaggacctg

SEQ ID NO: 2846 - RNA, 23 nt, synthetic construct
  source 1..23: mol_type = other RNA
cagcatcaaatttcaggacctgc

SEQ ID NO: 2847 - RNA, 23 nt, synthetic construct
  source 1..23: mol_type = other RNA
agcatcaaatttcaggacctgca

SEQ ID NO: 2848 - RNA, 23 nt, synthetic construct
  source 1..23: mol_type = other RNA
aaatttcaggacctgcagacagt

SEQ ID NO: 2849 - RNA, 23 nt, synthetic construct
  source 1..23: mol_type = other RNA
aatttcaggacctgcagacagta

SEQ ID NO: 2850 - RNA, 23 nt, synthetic construct
  source 1..23: mol_type = other RNA
ttcaggacctgcagacagtacag

SEQ ID NO: 2851 - RNA, 23 nt, synthetic construct
  source 1..23: mol_type = other RNA
aggacctgcagacagtacaggct

SEQ ID NO: 2852 - RNA, 23 nt, synthetic construct
  source 1..23: mol_type = other RNA
gacctgcagacagtacaggctag

SEQ ID NO: 2853 - RNA, 23 nt, synthetic construct
  source 1..23: mol_type = other RNA
acctgcagacagtacaggctaga

SEQ ID NO: 2854 - RNA, 23 nt, synthetic construct
  source 1..23: mol_type = other RNA
cctgcagacagtacaggctagat

SEQ ID NO: 2855 - RNA, 23 nt, synthetic construct
  source 1..23: mol_type = other RNA
tgcagacagtacaggctagataa

SEQ ID NO: 2856 - RNA, 23 nt, synthetic construct
  source 1..23: mol_type = other RNA
cagacagtacaggctagataacc

SEQ ID NO: 2857 - RNA, 23 nt, synthetic construct
  source 1..23: mol_type = other RNA
ttcctagccacctttctggcctc

SEQ ID NO: 2858 - RNA, 23 nt, synthetic construct
  source 1..23: mol_type = other RNA
acctttctggcctcccacttgcc

SEQ ID NO: 2859 - RNA, 23 nt, synthetic construct
  source 1..23: mol_type = other RNA
tttctggcctcccacttgccctg

SEQ ID NO: 2860 - RNA, 23 nt, synthetic construct
  source 1..23: mol_type = other RNA
caggcatcttgatcccagcctga

SEQ ID NO: 2861 - RNA, 23 nt, synthetic construct
  source 1..23: mol_type = other RNA
aggcatcttgatcccagcctgac

SEQ ID NO: 2862 - RNA, 23 nt, synthetic construct
  source 1..23: mol_type = other RNA
ctaccaatgcctcctgtccctaa

SEQ ID NO: 2863 - RNA, 23 nt, synthetic construct
  source 1..23: mol_type = other RNA
caatgcctcctgtccctaaactc

SEQ ID NO: 2864 - RNA, 23 nt, synthetic construct
  source 1..23: mol_type = other RNA
atgcctcctgtccctaaactccc

SEQ ID NO: 2865 - RNA, 23 nt, synthetic construct
  source 1..23: mol_type = other RNA
gcaaaaccctcgagacctctttg

SEQ ID NO: 2866 - RNA, 23 nt, synthetic construct
  source 1..23: mol_type = other RNA
aggaaagagcagatcccaggttt

SEQ ID NO: 2867 - RNA, 23 nt, synthetic construct
  source 1..23: mol_type = other RNA
cagtggacagtgaggacttcttc

SEQ ID NO: 2868 - RNA, 23 nt, synthetic construct
  source 1..23: mol_type = other RNA
agcaaaaccctcgagacctcttt

SEQ ID NO: 2869 - RNA, 23 nt, synthetic construct
  source 1..23: mol_type = other RNA
gcctgaatgtcaaagccacattc

SEQ ID NO: 2870 - RNA, 23 nt, synthetic construct
  source 1..23: mol_type = other RNA
cgggctctactctatgagttgtg

SEQ ID NO: 2871 - RNA, 23 nt, synthetic construct
  source 1..23: mol_type = other RNA
tgaatggagtgctaaccctggtg

SEQ ID NO: 2872 - RNA, 23 nt, synthetic construct
  source 1..23: mol_type = other RNA
tgaatggagtgctaaccctggtg

SEQ ID NO: 2873 - RNA, 23 nt, synthetic construct
  source 1..23: mol_type = other RNA
tgaatggagtgctaaccctggtg

SEQ ID NO: 2874 - RNA, 23 nt, synthetic construct
  source 1..23: mol_type = other RNA
agaccctactgctgaatggagtg

SEQ ID NO: 2875 - RNA, 23 nt, synthetic construct
  source 1..23: mol_type = other RNA
ggacctgcagacagtacaggcta

SEQ ID NO: 2876 - RNA, 23 nt, synthetic construct
  source 1..23: mol_type = other RNA
tgctgggaatttcctccaccctt

SEQ ID NO: 2877 - RNA, 23 nt, synthetic construct
  source 1..23: mol_type = other RNA
aagggccgcctccattcctacta

SEQ ID NO: 2878 - RNA, 23 nt, synthetic construct
  source 1..23: mol_type = other RNA
cattctacgggctctactctatg

SEQ ID NO: 2879 - RNA, 23 nt, synthetic construct
  source 1..23: mol_type = other RNA
ctgcagacagtacaggctagata

SEQ ID NO: 2880 - RNA, 23 nt, synthetic construct
  source 1..23: mol_type = other RNA
attggagaccctactgctgaatg

SEQ ID NO: 2881 - RNA, 23 nt, synthetic construct
  source 1..23: mol_type = other RNA
agacctctttggcagcctgaatg

SEQ ID NO: 2882 - RNA, 23 nt, synthetic construct
  source 1..23: mol_type = other RNA
cacctttctggcctcccacttgc

SEQ ID NO: 2883 - RNA, 23 nt, synthetic construct
  source 1..23: mol_type = other RNA
gatggaactgcagtggacagtga

SEQ ID NO: 2884 - RNA, 23 nt, synthetic construct
  source 1..23: mol_type = other RNA
ggaggatgacacgtgcctgatgg

SEQ ID NO: 2885 - RNA, 23 nt, synthetic construct
  source 1..23: mol_type = other RNA
ctgaatggagtgctaaccctggt

SEQ ID NO: 2886 - RNA, 23 nt, synthetic construct
  source 1..23: mol_type = other RNA
gagtgctgtcatatggcctggga

SEQ ID NO: 2887 - RNA, 23 nt, synthetic construct
  source 1..23: mol_type = other RNA
gagtgctgtcatatggcctggga

SEQ ID NO: 2888 - RNA, 23 nt, synthetic construct
  source 1..23: mol_type = other RNA
gagtgctgtcatatggcctggga

SEQ ID NO: 2889 - RNA, 23 nt, synthetic construct
  source 1..23: mol_type = other RNA
tggcccaaagaaagtactcaggg

SEQ ID NO: 2890 - RNA, 23 nt, synthetic construct
  source 1..23: mol_type = other RNA
aagtactcagggagctccttcgt

SEQ ID NO: 2891 - RNA, 23 nt, synthetic construct
  source 1..23: mol_type = other RNA
tgggaatttcctccacccttcgt

SEQ ID NO: 2892 - RNA, 23 nt, synthetic construct
  source 1..23: mol_type = other RNA
tgggaatttcctccacccttcgt

SEQ ID NO: 2893 - RNA, 23 nt, synthetic construct
  source 1..23: mol_type = other RNA
tgggaatttcctccacccttcgt

SEQ ID NO: 2894 - RNA, 23 nt, synthetic construct
  source 1..23: mol_type = other RNA
acgtgtacaagcaaaaccctcga

SEQ ID NO: 2895 - RNA, 23 nt, synthetic construct
  source 1..23: mol_type = other RNA
tgcagtctggtcagagctggagc

SEQ ID NO: 2896 - RNA, 23 nt, synthetic construct
  source 1..23: mol_type = other RNA
agtgctaaccctggtgctagagg

SEQ ID NO: 2897 - RNA, 23 nt, synthetic construct
  source 1..23: mol_type = other RNA
catcaaatttcaggacctgcaga

SEQ ID NO: 2898 - RNA, 23 nt, synthetic construct
  source 1..23: mol_type = other RNA
agagaaccacccagcccagaagt

SEQ ID NO: 2899 - RNA, 23 nt, synthetic construct
  source 1..23: mol_type = other RNA
ctcaaactaacaaaaacatttcc

SEQ ID NO: 2900 - RNA, 23 nt, synthetic construct
  source 1..23: mol_type = other RNA
accatggagtacctctcagctct

SEQ ID NO: 2901 - RNA, 23 nt, synthetic construct
  source 1..23: mol_type = other RNA
cttcgttggacctccacactgct

SEQ ID NO: 2902 - RNA, 23 nt, synthetic construct
  source 1..23: mol_type = other RNA
ccaccatggagtacctctcagct

SEQ ID NO: 2903 - RNA, 23 nt, synthetic construct
  source 1..23: mol_type = other RNA
ttggcagcctgaatgtcaaagcc

SEQ ID NO: 2904 - RNA, 23 nt, synthetic construct
  source 1..23: mol_type = other RNA
tttcctagccacctttctggcct

SEQ ID NO: 2905 - RNA, 23 nt, synthetic construct
  source 1..23: mol_type = other RNA
actgctgaatggagtgctaaccc

SEQ ID NO: 2906 - RNA, 23 nt, synthetic construct
  source 1..23: mol_type = other RNA
tttcaggacctgcagacagtaca

SEQ ID NO: 2907 - RNA, 23 nt, synthetic construct
  source 1..23: mol_type = other RNA
tgacagcatcaaatttcaggacc

SEQ ID NO: 2908 - RNA, 23 nt, synthetic construct
  source 1..23: mol_type = other RNA
tgttgctgggaatttcctccacc

SEQ ID NO: 2909 - RNA, 23 nt, synthetic construct
  source 1..23: mol_type = other RNA
ccaatgcctcctgtccctaaact

SEQ ID NO: 2910 - RNA, 23 nt, synthetic construct
  source 1..23: mol_type = other RNA
ctttgacgtgtacaagcaaaacc

SEQ ID NO: 2911 - RNA, 23 nt, synthetic construct
  source 1..23: mol_type = other RNA
agggccgcctccattcctactaa

SEQ ID NO: 2912 - RNA, 23 nt, synthetic construct
  source 1..23: mol_type = other RNA
ttactcaggtcagtatctaatat

SEQ ID NO: 2913 - RNA, 23 nt, synthetic construct
  source 1..23: mol_type = other RNA
cctgggccatatgttgctgggaa

SEQ ID NO: 2914 - RNA, 23 nt, synthetic construct
  source 1..23: mol_type = other RNA
agtgctgtcatatggcctgggac

SEQ ID NO: 2915 - RNA, 23 nt, synthetic construct
  source 1..23: mol_type = other RNA
tatgagttgtgactttcaaggac

SEQ ID NO: 2916 - RNA, 23 nt, synthetic construct
  source 1..23: mol_type = other RNA
agaggcccaagcacagcaaggac

SEQ ID NO: 2917 - RNA, 23 nt, synthetic construct
  source 1..23: mol_type = other RNA
cgtgtacaagcaaaaccctcgag

SEQ ID NO: 2918 - RNA, 23 nt, synthetic construct
  source 1..23: mol_type = other RNA
cgtgtacaagcaaaaccctcgag

SEQ ID NO: 2919 - RNA, 23 nt, synthetic construct
  source 1..23: mol_type = other RNA
cgtgtacaagcaaaaccctcgag

SEQ ID NO: 2920 - RNA, 23 nt, synthetic construct
  source 1..23: mol_type = other RNA
actctatgagttgtgactttcaa

SEQ ID NO: 2921 - RNA, 23 nt, synthetic construct
  source 1..23: mol_type = other RNA
gcaaagactatgacagcatcaaa

SEQ ID NO: 2922 - RNA, 21 nt, synthetic construct
  source 1..21: mol_type = other RNA
  modified_base 1: mod_base = OTHER; note = 2'-O-methylcytidine-3'-phosphorothioate
  modified_base 2: mod_base = OTHER; note = 2'-O-methyluridine-3'-phosphorothioate
  modified_base 3: mod_base = OTHER; note = 2'-O-methylguanosine-3'-phosphate
  modified_base 4: mod_base = OTHER; note = 2'-O-methylcytidine-3'-phosphate
  modified_base 5: mod_base = OTHER; note = 2'-O-methyladenosine-3'-phosphate
  modified_base 6: mod_base = OTHER; note = 2'-O-methylguanosine-3'-phosphate
  modified_base 7: mod_base = OTHER; note = 2'-deoxy-2'-fluoroadenosine-3'-phosphate
  modified_base 8: mod_base = OTHER; note = 2'-O-methyladenosine-3'-phosphate
  modified_base 9: mod_base = OTHER; note = 2'-deoxy-2'-fluoroguanosine-3'-phosphate
  modified_base 10: mod_base = OTHER; note = 2'-deoxy-2'-fluoroguanosine-3'-phosphate
  modified_base 11: mod_base = OTHER; note = 2'-deoxy-2'-fluorouridine-3'-phosphate
  modified_base 12: mod_base = OTHER; note = 2'-O-methyluridine-3'-phosphate
  modified_base 13: mod_base = OTHER; note = 2'-O-methylguanosine-3'-phosphate
  modified_base 14: mod_base = OTHER; note = 2'-O-methyladenosine-3'-phosphate
  modified_base 15: mod_base = OTHER; note = 2'-O-methylcytidine-3'-phosphate
  modified_base 16: mod_base = OTHER; note = 2'-O-methyluridine-3'-phosphate
  modified_base 17: mod_base = OTHER; note = 2'-O-methylguanosine-3'-phosphate
  modified_base 18: mod_base = OTHER; note = 2'-O-methylcytidine-3'-phosphate
  modified_base 19: mod_base = OTHER; note = 2'-O-methylguanosine-3'-phosphorothioate
  modified_base 20: mod_base = OTHER; note = 2'-O-methyluridine-3'-phosphorothioate
  modified_base 21: mod_base = OTHER; note = 2'-O-methyluridine
ctgcagaaggttgactgcgtt
